United States Patent 10,004,800 (ANTIBODY EVOLUTION IMMUNOGENS) - sequence listing, part 2

SEQ ID NO: 649 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaaaaagtataagaataggaccaggacaagcattttatgcaacaggacaagtaataggagacataagagaagcatattgtaacattaatgaaagtaaatggaatgaaactttacaaagggtaagtaaaaaattaaaagaatatttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 650 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagaaataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagcagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 651 - DNA, 2562 bp, Human immunodeficiency virus
atgagagtgatggggatacagaggaattatccacaatggtggatatggagcatgttaggcttttggatgctaatgatttgtaacgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaataccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 652 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaataccaatgctactgccagcaatagcagtacaatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatacagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagcaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 653 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaataccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgcaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcagtgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 654 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 655 - DNA, 2556 bp, Human immunodeficiency virus; identical to SEQ ID NO: 654

SEQ ID NO: 656 - DNA, 2551 bp, Human immunodeficiency virus
atgagagtgatggggatacagaggaattatccacaatggtggatatggagcatgttaggattttggatgctaatgatttgtaacgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcactttttttataaacttgatatagtacaactagatggcaactctagtcagtatagattaataaattgtaatacctcagtcataacacaagcctgtccaaaggtctcttttgacccaatacctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 657 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggatcgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgagggggccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagaactatccgcaacatacctacaagaataagacagggctttgaaacagctttgctataa

SEQ ID NO: 658 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggatcgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 659 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 660 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaacctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagtagtaggtgaaggaacagataggattctagaatttgtattaggaatttgtagagctatccgcaacatacctacaagaataagacagggctttgaaacagctttgctataa

SEQ ID NO: 661 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatgtaaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 662 - DNA, 2553 bp, Human immunodeficiency virus
atgagagtgatggggatacagaggaatcatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgggcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 663 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaccaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 664 - DNA, 2552 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggagggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaactggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactatggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 665 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacatatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccggcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataagacaaattataaacatgtggcaggaggtgggacgagcaatgtatgcccctcccattgcaggaaacataacatatatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 666 - DNA, 2538 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtgcatctcaatgaatctgtaaagattgagtgtacgagacccaataacaaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacgttcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtactattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 667 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagaggaaatgaaaaattgctctttcaatataatcacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaacatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 668 - DNA, 2551 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggatcgtgtaataatgtcagcacagtacaatgtacacatggaattaagccagtggtttcaactcaactattgttaaatggtagtctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagtaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 669 - DNA, 2538 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtatagagggaatgaaaaattgctctttcaatataaccacagaattaagagataagagagagaaaaagaatgcacctttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtaaacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactaaggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 670 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgttcccacagaccccaatccacaagaaatggtgttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 671 - DNA, 2507 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 672 - DNA, 2527 bp, Human immunodeficiency virus
atgagagtgatggggatacagaggaattatccacaatggtggatatggagcatgttaggcttttggatgctaatgatttgtaaagggatgtgggtcacagtctactatggggtacctgtgtggaaagaagcaaaaactactctattttgtgcatcagatgctaaagcatatgagaaagaagtgcataatgtttgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatatcagtaatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacagacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 673 - DNA, 2574 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 674 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaacatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacgatacggagacattcagacctggaggaggaaatatgaaggataattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttatattaggaatttgtagagctatccgcaacatacctacaagaataagacagggctttgaaacagctttgctataa

SEQ ID NO: 675 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgttactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactccagtcagtatagattaataaattgtaatacctcagtcataacacaagcctgtccaaaggtctcttttgacccaattcctatacattattgtgctccagctggttatgcgattctaaagtgtaataataagacattcactggaacaggatcgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccaataataaaacaagaacaagtataagaataggaccaggacaagcattttatgcaacaggacaagtaataggagacataaaagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaacatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 676 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagctgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctaggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 677 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaagtattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 678 - DNA, 2558 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaatgacatggtggatcagatgcatgaagacgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 679 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataaggataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 680 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgcacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacaatctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 681 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaattattgttaaatggtagcctagcagaaggagagataataattagatctgaaaatataacaaacactgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 682 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccggctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatccggagacattcagacctggaggaggaaatatgaaggacaattggagaagtgaattatataaatataaagtggtagaagttaagccattaggagtagcacccactaatgcaagaaggagagtggtggagagagaaaaaagagcagtgggtttgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagtagtaggtgaaggaacagataggattctagaatttgtattaggaatttgtagagctatccgcaacatacctacaagaataagacagggctttgaaacagctttgctataa

SEQ ID NO: 683 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgacccccctctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcayattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcamamtccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 684 - DNA, 2559 bp, Human immunodeficiency virus
atgagagtaatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgacccccctctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgttagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaataaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaagatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 685 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgacccccctctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggcttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 686 - DNA, 2559 bp, Human immunodeficiency virus
atgagagtgatggggatacagaggaattatccacaatggtggatatggagcatgttaggcttttggatgctaatgatttgtaacgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacaactcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 687 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 688 - DNA, 2562 bp, Human immunodeficiency virus; identical to SEQ ID NO: 687

SEQ ID NO: 689 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatcccctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttaataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 690 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagcataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccagtaataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 691 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatgggtttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcatcagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattacagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 692 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataataaagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaacaataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggagaaggaaatatgaaggacaattgaagaagtaaattatataaatataaagtggtagaagttaagccattaggagtagcacccactaatgcaagaaggagagtggtgaagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatataaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaaaaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 693 - DNA, 2562 bp, Human immunodeficiency virus
atgagagtgatggggatacaaaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 694 - DNA, 2544 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataacacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 695 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataacacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagcgttgctataa

SEQ ID NO: 696 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagatgaccccactctgtgtcactctaaactgtaccaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttagaaagatacctaaaggatcaacagctcctagggatgtggggctgctctggaaaactcatctgcaccactaatgtatattggaactctagttggagtaataaaagttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 697 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagatgaccccactctgtgtcactctaaactgtaccaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacggaaactaacaatacacgacccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggaatagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttagaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 698 - DNA, 2565 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacagtggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcatcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaagtatcacaggactactattgacaagggatggaggagaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgttttctttagtaaatagagttaggcagggatactcacctctatcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 699 - DNA, 2577 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagaaagacagaaacagatcaacgcgactagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 700 - DNA, 2486 bp, Human immunodeficiency virus
atgagagtgatggggatacagaggaattatccacaatggtggatatggagcatgttaggcttttggatgctaatgatttgtaaagggatgtgggtcacagtctactatggggtacctgtgtggaaagaagcaaaaactactctattttgtgcatcagatgctaaagcatatgagaaagaagtgcataatgtttgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatatcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacagacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 701 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 702 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtgtctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 703 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacctactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 704 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagrcagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 705 - DNA, 2565 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccatcaatatcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccaataataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggttaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaataacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 706 - DNA, 2033 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggtgttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacatatatggctaatagtacagatactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtagtatataaaaatattcataatgatagtaggaggcttgataggtttaagaataatttttgctgtgttttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggaggggatgggaagcccttaagtatctgggaagtcttgggcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 707 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagttttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtagtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaacaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 708 - DNA, 2547 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacagacccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaagaagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 709 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagtgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 710 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactttattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttaaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagcggtggagagagaaaaaagagcagtgggaatgggagctgtgttccttgggttcttaggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 711 - DNA, 2580 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataacaagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaaataaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 712 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtctttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 713 - DNA, 2580 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 714 - DNA, 2556 bp, Human immunodeficiency virus
atgagagtgatggggatacaaaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcagaagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatgggggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 715 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtaggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaagatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagtgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 716 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagttttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggaagagcaatgtatgcccctcccattgcaggaaacataacatgtatatcaaatatcacaggactactattgacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctataggggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 717 - DNA, 2580 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 718 - DNA, 2580 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataatagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 719 - DNA, 2538 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacaggtggaaaaatgacatggtggatcagatgcatgaagatgtaattagtttatgggatcaaagcctcaagccctgtgtaaagttgaccccactctgtgtcactctaaactgtaccgatgctaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggaaagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcaatctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 720 - DNA, 2580 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgaacaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaaaaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 721 - DNA, 2580 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaaggaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaactgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 722 - DNA, 2529 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagggggtgggaagcccttaagtatctgagaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 723 - DNA, 2589 bp, Human immunodeficiency virus
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatagcagtataatagagggaatgaatagtagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaacaggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 724 - DNA, 2580 bp, Human immunodeficiency virus
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatagcagtataatagagggaatgaatagtagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaacaggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 725 - DNA, 2589 bp, Human immunodeficiency virus
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatagcagtataatagagggaatgaatagtagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaacaggacatatatggctactagtacagatatggctaatagtacggaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 726 - DNA, 2580 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattaatttatgggatcaaagcctcaagccatgtgtaaagttgaccccactctgtgtcactctaaactgtaccgatgctactgccagcaatgctactgccagcaatgctactgccagcaatagcagtatcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtatcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaagttacaacacatagctttaattgtggaggagaatttttctattgcaatacatcaagcctgtttaataggacagatatggctaatagtacagaaactaacagtacacgaatcatcacaatccgctgcagaataaaacaaattgtaaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgtaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 727 - DNA, 2580 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtatcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtatcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaagttacaacacatagctttaattgtggaggagaatttttctattgcaatacatcaagcctgtttaataggacagatatggctaatagtacagaaactaacagtacacgaatcatcacaatccgctgcagaataaaacaaattgtaaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgtaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 728 - DNA, 2583 bp, Human immunodeficiency virus
atgagagtgatggggatacagaggaattatccacaatggtggatatggagcatgttaggcttttggacgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatactactgccagcaatagcaatataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagcaaaaaattaaaagaatacttccctcataagaatataacatttcaaccatcctcaggaggggacctagaagttacaacacatagctttaattgtggaggagaatttttctattgcaatacatcaagcctgtttaataggacagatatggctaatagtacagaaactaacagtacacgaatcatcacaatccgctgcagaataaaacaaattgtaaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggctgggaagcccttaagtatctgggaggtcttgtgcagtattggggcctagaactaaaaaggagtgctattagtctattggataccctagcaatagcagtaggtggaggaacagataggattctagaatttgtattaggaatttgtagagctatccgcaacatacctacaagaataagacagggctttgaaacagctttgctataa

SEQ ID NO: 729 - DNA, 2580 bp, Human immunodeficiency virus
atgagagtgatggggatacagagcaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcagatcagatgcatgaagatgtaattagtttatgggatcaaagcctcaagccatgtgtaaagttgaccccactctgtgtcactctaaactgtaccgatgctactaccaatgctactgccagcaatgctactgccagcaatgctactgccagcaatagcagtataatagagggaatgaaaaattgctctttcaatataaccacagaattaagagataagacagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaagttacaacacatagctttaattgtggaggagaatttttctattgcaatacatcaagcctgtttaataggacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatgaaggaaaaaacaatacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacaaatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagtgagagcgggggaacttctggaacgcagcagtctcaagggactacggagaggatgggaagcccttaagtatctgggaggtcttgtgcagtattggggcctggaactaaaaaggagtgctattagtctattagataccctagcaatagcagtaggtgaaggaacagataggattctagaatttgtattaggaatttgtagagctatccgcaacatacctacaagaataagacagggctttgaaacagctttgctataa

SEQ ID NO: 730 - DNA, 2568 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcacgccatgtgtaaagttgaccccactctgtgtcactctaaactgtaccgatgctactgccagcaatgctactgccagcaatgctactgccagcaatgctactgccagcagtagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacccagaaattacaacacatagctttaattgtggaggagaatttttctattgcaatacatcaagcctgtttgataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaacagcagtacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgtttgcctgggacgacctgcggagcctgtgccttttcatctaccaccgattgagagacttcatattaattgcagcgagagcgggggaacttctgggacgcagcagtctcaagggactacggaggggatgggaagcccttaagtatttgggaggtcttgtgcagtattggggcctggaactaaaaaagagtgctattagtctattggataccctagcaatagcagtaggtgaaggaacagataggattctagaatttgtattaggaatttgtagagctatccgcaacatacctacaagaacaagacagggctttgaaacagctttgctataa

SEQ ID NO: 731 - DNA, 2580 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctaataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgagactcacggtctggggcattaaacagctccaggcaagagtcctggccttagaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaacaatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtactttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 732 - DNA, 2589 bp, Human immunodeficiency virus
atgagagtgatggggatacagaggaattatccacaatggtggatatggggcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcagatcagatgcatgaagatgtaattagtttatgggatcaaagcctcaagccatgtgtaaagttgaccccactctgtatcactctaaactgtaccgatgctactgccagcaatgctactgccagcaatgctactgccagcaatgctactgccagcagtataatagagggaatgaaaaattgctctttcaatataaccacagaattaagagataagatagagaaaaggaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtggcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctaataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagagagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacaaggctttgaaacagctttgctataa

SEQ ID NO: 733 - DNA, 2595 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatgctactgccagcaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcagaagaatataacatttcaaccatcctcaggaggggacctagaaattacaacacatagctttaattgtggaggagaatttttctattgcaatacatcaagcctgtttaatagaacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaacaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgccataa

SEQ ID NO: 734 - DNA, 2598 bp, Human immunodeficiency virus
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctaataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggccgggaactaaaaaggagtgctattagtctattggataccctagcaatagcagtaggtgaaggaacagataggattctagaatttgcattaagaatttgtagagctatccgcaacatgcctacaagaataagacagggctttgaaacagctttgctataa

SEQ ID NO: 735 - DNA, 2592 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcagaagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgatatgtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 736 - DNA, 2589 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcacgccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccgaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctaataagaatataacatttcaaccatcctcaggaggggacctagaaattacaacacatagctttaattgtggaggagaatttttctattgcaatacatcaagcctgtttaataggacatatatgtttaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaacagcagtacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagggagaaattagcaattatacagaaataatatataaattgcttgaagaatcacaaaaccagcaggaaaagaatgaacaagatttattagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgcctgggacgacctgcggagcctgtgccttttcatctaccaccgattgagagacttcatattaattgcagcgagagcaggggaacttctgggacgcagcagtctcaagggactacggagaggatgggaagcccttaagtatctgggaagtcttgtgcagtattggggccgggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 737 - DNA, 2586 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtgccgatgctactaccaatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccagggcaagcattttatgcaacaggacaagtaataggagacataagagaagcacattgtaacattagtgaaagtaaatggaatgaaactttacaaagggtaagtaaaaaattaaaagaatacttccctcttaagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaacaatacgaatacggagacattcagacctggaggaggaaatatgaaggacaattggagaagtgaattatataaatataaggtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 738 - DNA, 2607 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaatagcagtataatagagggaatgaaaaattgctctttcagtataaccacagaattaagagataagagagagaaaaagtatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctgaaaacataacagacaatggcaaaacaataatagtgcatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattagaagaatacttccctcataaggatataacatttcaaccatcctcaggaggggacctagaagttacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacagggatagaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 739 - DNA, 2571 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcgatagcagtataatagagggaatgaaaaattgctctttcaatataaccacagaattaagagataagagagagaaaaagtatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacctagaagttacaacacatagttttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggaggggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 740 - DNA, 2547 bp, Human immunodeficiency virus
atgagagtgacggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcagatcagatgcatgaagatgtaattagtttatgggatcaaagcctcaagccatgtgtaaagttgaccccactctgtgtcactctaaactgtatcgatgccaatgctactgccagcaatgctactgccagcaatagcagtataatagagggaatgaaaaattgctctttcaatataaccacagaattaagagataagatagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaataacaatactacggagacattcagacctggaggaggaaatatgaaggacaattggagaagtgaattatataaatataaagtggtagaaattaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtcgttgcagacccttaccccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 741 - DNA, 2538 bp, Human immunodeficiency virus
atgagagtgatggggatacagaggaattatacacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcttgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaaattgaccccactctgtgtcactctaaactgtgccaatgctactaatgctactgccagcaatagcagtatattagaggaaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccactgcagaataaaacaaattataaacatgtggcaggaggtgggacgagcaatgtatgccccccccattgcaggaaacataacatgtatatcaaatatcacaggactactattgacaagggatggaggaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 742 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagacctcaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcaatgctactgccagcaatgctactgccagcaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcagaagaatataacatttcaaccatcctcaggaggggacctagaaattacaacacatagctttaattgtggaggagaatttttctattgcaatacatcaagcctgtttaatagaacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctaaagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaacaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 743 - DNA, 2559 bp, Human immunodeficiency virus
atgagagtgatggggatacagaggaactatacacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaataataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaacaggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtagtagaagtcaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagctcttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 744 - DNA, 2559 bp, Human immunodeficiency virus
atgagagtgatggggatacagaggaattatacacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccatagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttgtgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaacaggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagtcaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaactggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagctcttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 745 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttaaccccactctgtgtcactctagactgtatcaatgctactaatgctactgccagcaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggttaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 746 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacataagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacagagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagaaagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgcgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 747 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttacgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 748 - DNA, 2559 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaataacagtatattagagggaatgaaaaattgctctttcaatatagccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttagttgtggaggagaatttttctattgcaatacatcaagcctgtttaataggacatatatggctactaatacagatatggctaatagtacagaaactaacagtacacgaatcatcacaatccgctgcagaataagacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 749 - DNA, 2550 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaagctgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaaatcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 750 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaagctgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 751 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggagcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaagttacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcatttcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 752 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcgatgctactgccagcaatgctactgccatcaatatcagtataatagaggaaatgaaaaattgctctttcaatataaccacagaattaagagataagagagagaaaaagaatgcacttttttataaacttgatatagtacaactagatggcaactctagtcagcatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 753 - DNA, 2562 bp, Human immunodeficiency virus; identical to SEQ ID NO: 752

SEQ ID NO: 754 - DNA, 2562 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcgatgctactgccagcaatgctactgccatcaatatcagtataatagaggaaatgaaaaattgctctttcaatataaccacagaattaagagataagagagagaaaaagaatgcacttttttataaacttgatatagtacaactagatggcaactctagtcagcatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtaaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaaaaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 755 - DNA, 2577 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatggggaaaaatgacatggtggatcagatgcatgaagatgtaattagtttatgggatcaaagcctcaagccatgtgtaaagttgaccccactctgtgtcactctaaactgtaccgatgctaatgctactgccagcaatagcagtataatagagggaatgaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 756 - DNA, 2580 bp, Human immunodeficiency virus
atgagagtgatggggatacagaggaattatacacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgttaatgctactgccagcaatagcagtataatagagggaatgaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtgggactggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 757 - DNA, 2580 bp, Human immunodeficiency virus; identical to SEQ ID NO: 756

SEQ ID NO: 758 - DNA, 2580 bp, Human immunodeficiency virus; identical to SEQ ID NO: 756

SEQ ID NO: 759 - DNA, 2580 bp, Human immunodeficiency virus
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgcgtacccacagaccccaatccacaagaaatggttttaaaaaatgtaacagaaaagttcaacatgtggaaaaatgacatggtggatcagatgcatgaagatgtaattagtttatgggatcaaagcctcaagccatgtgtaaagttgaccccactctgtgtcactctaaactgtaccaatgttaatgctactgccagcaatagcagtataatagagggaatgaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcagaagaatataacatttcaaccatcctcaggaggggacctagaaattacaacacatagctttaattgtggaggagaatttttctattgcaatacatcaagcctgtttaatagaacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaaaaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcacattaattgcagcgagagcgggggaacttctgggacgcagcagtctcaagggactatggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 760 - DNA, 2551 bp, Human immunodeficiency virus
gagagtgatggggatacagaggaattatccacaatggtggatatggagcatgttaggcttttggatgctaatgatttgtaatgggatgtgggtcacagtctactatggggtacctgtgtggaaagaagcaaaaactactctattctgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaagagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggttaatagtacagatatggctaatagtacagaaactaacagtacacgaaccatcacaatcagctgcagaataaaacaaattataaacatgtggcaggaggtgggacgagcaatgtatgcccctcccattgcaggaaacataacatgtatatcaaatatcacaggactactattgacaagggatggaggaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagccgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatttaccaccgattgagagacttcatattaattgcagcgagagtgggggaacttctgggacgcaacagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 761 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcacaagaatataacatttcaaccatcctcaggaggggacctagaaattacaacacatagctttaattgtagaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatgggggagaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 762 - DNA, 2553 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcagaagaatataacatttcaaccatcctcaggaggggacctagaaattacaacacatagctttaattgtggaggagaatttttctattgcaatacatcaagcctgtttaatagaacatatatggctactagtacagatatggctaatagtacagaaactaacagtacacgaatcatcacaatccgctgcaggataaaacaaattataaacatgtggcaggaggtgggacgagcaatgtatgcccctcccattgcaggaaacataacatgtatatcaaatatcacaggactactattgacaagggatggaggaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 763 - DNA, 2553 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcaatatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaatataacatgtatatcaaatatcacaggactactattgacaagggatggagggaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaactattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaaggaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 764 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcaatatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggctcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacagagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 765 - DNA, 2555 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctactaatacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 766 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgatccaattcctatacattattgtgctccagctggttatgcgattctaaagtgtaataataaaacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaacgtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagtctgtttaataggacatatatggttaatagtacagatatggctaatagtacagaaactaacagtacacgaaccatcacaatcagctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 767 - DNA, 2556 bp, Human immunodeficiency virus
atgagagtgatggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacgcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaaatctgtttaataggacatatatggttaatagtacagatatggctaatagtacagaaactaacagtacacgaaccatcacaatcagctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 768 - DNA, 2556 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattccaatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggttaatagtacagatatggctaatagtacagaaactaacagtacacgaaccatcacaatcagctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 769 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactaatgctactgccagcaatagcagtatattagggggaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgcgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaatgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 770 - DNA, 2577 bp, Human immunodeficiency virus
atgagagtgatggggatacagaagaattgtccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtactgatgctaatgctactgccagcaatagcagtataataaagggaatgaatagcagtatgatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcagaaagatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacagaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgaaagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 771 - DNA, 2577 bp, Human immunodeficiency virus
atgagagtgagggggatacagaggaattatccacaatggtggatatggagcatgttaggcttttggatgctaatgatttgtaatggaatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctaatgctactgccagcaatagcagtataataaagggaatgaatagcagtatgatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgtaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 772 - DNA, 2571 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaaaaagcaaaaactactctattttgtgcatcagatgctaaagcatatgagaaagaagtgcatagtgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctaatgctactgccagcaatagcagtataataaagggaatgaatagcagtatgatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggcagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataggaatataacatttcaaccatcctcaggaggggacccagaaattacaacacatagctttaattgtggaggaaaatttttctattgcaatacatcaagcctgtttaatagaacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaataacaatacggagacattcagacctgtaggaggaaatatgaaggacaattggagaagtaaattatataaatataaagtggtagaagttaagccattaggagtagcacccactaaggcaagaaggagaatggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaaaaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagactttatattaattgcagcgagagcgggggaacttctgggacgcagcagtctcaagggactacggagaggatgggaagcccttaagtatctggaaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 773 - DNA, 2589 bp, Human immunodeficiency virus
atgagagtgatggggaggcagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagaacagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaacagcagtacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattatacagaaatgatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtactttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtttattggataccctagcaatagcagtaggtgaaggaacagataggattctagaatttgtattaggaatttgtagagctatccgcaacatacctacaagaataagacagggctttgaaacagctttgctataa

SEQ ID NO: 774 - DNA, 2604 bp, Human immunodeficiency virus
atgagagtgatggggatacagaggaattatccacaatggtggatatggagcatgttaggcttgtggatgctaatgacttgtaatgggatgtgggtcacagtctactatggggtacctgtgtggaaagaagcaaaaactactctattttgtgcatcagatgctaaagcatatgagaaagaagtgcataatgtctgggccacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 775 - DNA, 2565 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaatatcaatgctactaccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacacaagcctggccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagacctaaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 776 - DNA, 2569 bp, Human immunodeficiency virus
gagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccaggcaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 777 - DNA, 2571 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 778 - DNA, 2593 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaaaatatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaagctcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 779 - DNA, 2592 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatactaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 780 - DNA, 2592 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagtaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 781 - DNA, 2592 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 782 - DNA, 2592 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaagaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 783 - DNA, 2592 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctggaaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 784 - DNA, 2592 bp, Human immunodeficiency virus
atgaaagtgagggggatacagaggaattatccacaatggtggatatggagcatgttaggcttgtggatgctaatgatttgtaatgggatgtgggtcacagtctattatggggtacctgtgtggaaagaagcaaaaactactctattttgtgcatcagatgctaaagcatatgagaaagaagtgcataatgtctgggctacacatgcctgtgtacccacagaccccaatccacaagaaatggttttagaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataaggataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcagggaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 785 - DNA, 2592 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatgctaatgctactgccagcaataccaatgctactgtcagcaatagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactactgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacccagaaattacaacgcatagttttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcatcaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 786 - DNA, 2592 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgccagcaataccaatgctactgtcagcaatagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacccagaaattacaacacatagttttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacagagaggatgggaagcccttaagtatctgggaggtcttgtgcagtattggggcctggaactaaaaaagagtgctattagtttattggataccctagcaatagcagtaggtgaaggaacagataggattctagaatttgtattaggaatttgtagagctatccgcaacatacctacaagaataagacagggctttgaaacagctttgctataa

SEQ ID NO: 787 - DNA, 2574 bp, Human immunodeficiency virus
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaaatatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatagaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggacggaggaaacgatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaagaatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggagaacttctgggacgcagcagtctcaagagactacggaggggatggaaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 788 - DNA, 2658 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaaaggttttaaaaaatgtaacagatgctaaagcatatgagaaagaagtgcataatgtctgggctacacatgcctgtgtacccacagaccccaatccacaagaaaaggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattggcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 789 - DNA, 2514 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcagctctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatgcctacaagaataagacagggctttgaaacagctttgctataa

SEQ ID NO: 790 - DNA, 2556 bp, Human immunodeficiency virus
atgagagtgatggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgcgtcactctaagctgtatcaatgctactaatgctactgacagcaataacagtatattagagggaatgaaaaattgctctttcaatataaccacagaattaagagataagagagagaaaaagaatgcacttttttataaacttgatatagtacaactatatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatctagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgggcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 791 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctggaacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacggctttgctataa

SEQ ID NO: 792 - DNA, 2554 bp, Human immunodeficiency virus
gagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggactgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaattaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 793 - DNA, 2558 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcgcaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 794 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtgataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcagctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 795 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggagatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttggtaggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 796 - DNA, 2556 bp, Human immunodeficiency virus
atgagagtgagggggatacagaggagttatccacaatggtggatatggagcatgttaggcttttggatgctaatgatttgtaatgggatgtgggtcacagtctattatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 797 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacacgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 798 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattactgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 799 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgggcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 800 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 801 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaatataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 802 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 803 - DNA, 2557 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 804 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaacctactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcatagcacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 805 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataaggcattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccattgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgttataa

SEQ ID NO: 806 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaagtggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatatcggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcactggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 807 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggagagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagataatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtaaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtatagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaataaagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 808 - DNA, 2559 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacgatacggatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 809 - DNA, 2559 bp, Human immunodeficiency virus
atgagagtgatggggacacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctatactgtatcaatgctactgccaatgctactgtcagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaacccaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaagaggtgggacgagcaatgtatgcccctcccattgcaggaaacataacatgtatatcaaatatcacaggactactattgacaagggatggaggaaacagcagtaaggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacctaatatatgacttgcttgaagaatcacaaaaccagcaggaaaagaatgaacaagatttattagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcctctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 810 - DNA, 2535 bp, Human immunodeficiency virus
atgagagtgatggggatacagaggaattgtccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtgaatcagatgcatgaagatgtaattagtttatgggatcaaagcctcaagccatgtgtaaagttgaccccactctgtgtcactctatactgtaccaatgctactgccaatgctactgtcagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtgaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacgatacggagacattcagacctgtaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacaaacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtattgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 811 - DNA, 2553 bp, Human immunodeficiency virus
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcacatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctatactgtaccaatgctactgccaatgctactgtcagcaatagcagtataatagaggaaatgaaaaattgctctttcaatataaccacagaattaagagataagagagagaaaaagtatgcacttttttataaacttgatatagtacaactagatggcaactctagtggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggccaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtgaaaaattaaaagaatacttccctaataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtaaggagacagagacattcagacctggaggaggaaatatgaaggacaattggagaagtgaattatataaatataaagtggtagaggttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttggaataacatgacctggatgcagtgggagagagaaattagcaattatacagacatgatatataatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 812 - DNA, 2565 bp, Human immunodeficiency virus
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaaatgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctaatgatgctaatgctactgccagcaataccaatgctactgtcagcaataatagcagtataatagaggaaatgaaaaattgctctttcaatataaccacagaattaagagataagatagagaaaaagtatgcacttttttataaacttgatatagtacaactagatggcaactctagtcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaacacaataatagtacatctcaatgaatctgtaaagattgagtgtacgagacccagtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggacggaggaaacactacggatatggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctagatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaagagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 813 - DNA, 2574 bp, Human immunodeficiency virus
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgtcagcaatatcaaggctactgtcagcaatagcagtataatagaggaaatgaaaaattgctctttcaatataaccacagaattaagagataagatagagaaaaagtatgcacttttttataaacttgatatagtacaactagatggcaactctactcagtatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccggcaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaaattacaacacatagctttaattgtggaggagaatttttttattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaacactacggatatagagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcgataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattacacagaaataatatatgacttgcttgaagaatcacaaaaccagcaggaaaagaatgaacaagatttactagcattggacaggtggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtattgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 814 - DNA, 2580 bp, Human immunodeficiency virus
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaatgctaatgctactgccagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcagtatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaacacaataatagtacatctcaatgaatctgtaaagattgagtgtacgagacccagtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctgataagaatataacatttcaaccatcctcaggaggggacccagaaattacaacacatagctttaattgtggaggagaatttttttattgcaatacatcaagcctgtttaataggacatacatggctaatagtacagaaactaacagtacacgaaccatcacactccactgcagaataaaacaaattataaacatgtggcaagaggtgggacgagcaatgtatgcccctcccattgcaggaaacataacatgtatatcaaatatcacaggactactattgacaagggatggaggaaacagcagtaaggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagggagaaattagcaattatacagaaataatatataacttgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 815 - DNA, 2574 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtctatgggatcaaagcctcacgccatgtgtaaagttgaccccactctgtgtcactctaacctgtaccgatgctaatgctactgccagtaatgctactgccagcaataccaatgctactgccagcaatagcagtataatgatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggagtgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacagatatggctaatagtacagaaactaacagtacacgaatcatcacactccactgcagaataaaacaaattataaacatgtggcaagaggtgggacgagcaatgtatgcccctcccattgcaggaaacataacatgtatatcaaatatcacaggactactattgacaagggatggaggaaacagcagtaaggagacagagacattcagacctggaggaggaaatatgaaggataattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagaaagaaattagcaattatacagaaatgatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggagcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 816 - DNA, 2577 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtactgatgctaatgatactgccagcaatagcagtataataaagggaatgaataacagtatagtaggggaaatgaaaaattgctctttcaatataaccacagaattaagagataagagagagaaaaagaatgcacttttttataaacttgatatagtacaactagatggcaactctagtgagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatatatggctaatagtacagatatggctaatagtgcagaaactaacagtacaagaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagggagaaattagcaattatacaaacataatatatgacttgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 817 - DNA, 2577 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctaatgatactgccagcaatagcagtataataaagggaatgaataacagtatagtaggggaaatgaaaaattgctctttcaatataaccacagaattaagagataagagagagaaaaagaatgcacttttttataaacttgatatagtacaactagatggcaactctagtgagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatatatggctaatagtacagatatggctaatagtgcagaaactaacagtacaagaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagggagaaattagcaattatacaaacataatatatgacttgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 818 - DNA, 2577 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctaatgatactgccagcaatagcagtataataaagggaatgaataacagtatagtaggggaaatgaaaaattgctctttcaatataaccacagaattaagagataagagagagaaaaagaatgcacttttttataaacttgatatagtacaactagatggcaactctagtgagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatatatggctaatagtacagatatggctaatagtgcagaaactaacagtacaagaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagcgaaattagcaattatacaaacataatatatgatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtactttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 819 - DNA, 2577 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctaatgatactgccagcaatagcagtataataaagggaatgaataacagtatagtaggggaaatgaaaaattgctctttcaatataaccacagaattaagagataagagagagaaaaagaatgcacttttttataaacttgatatagtacaactagatggcaactctagtgagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatatatggctaatagtacagatatggctaatagtgcagaaactaacagtacaagaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctggaggaggaaatatgaaggacaattggagaagtgaattatataaatataaagtggtagaagttaagccattaggaatagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagcgaaattagcaattatacaaacataatatatgatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtactttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 820 - DNA, 2553 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtggcaactctaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcaaaagaatataacctttcaaccatcctcaggaggggacctagaaattacaacacatagctttaattgtggaggagaatttttctattgcaatacatcaagcctgtttaataggacatatatggctactggtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacagtacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctgtaa

SEQ ID NO: 821 - DNA, 2557 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcactttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatgtcacaggactactattgacaagggatggaggaaataatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 822 - DNA, 2548 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataaggataggaccaggacaagcattttatgcaacaggacaagtaataggaaatataagagaagcacattgtaacattagtgaaagtaaatggaatgagactttacaaagggtaagtgaaaaattaaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcaggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 823 - DNA, 2556 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcagtatattagggggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttagtaggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattatacagacctaatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 824 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacagggccatgtaataatgtcagcacagtacaatgtacacatggaattaagccagtggtttcaactcaactattgttaaatggtagcctagcagaaggagagataataattagatctaaaaatataacagacaatagcaaaacaataatagtacatttcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 825 - DNA, 2574 bp, Human immunodeficiency virus
atgagagtgacggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaaggatatgagaaggaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctatactgtaccaatgctactgctaatgctactgccagcaatatcaatgttactgtcagcaatagcagtataatagaggaaatgaaaaattgctctttcaatataaccacagaattaagagataagagagagaaaaagtatgcacttttttataaacttgatataatacaactagatggcagctctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataggaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaagttacaacacatagctttaattgtggaggagaatttttctattgcaatacatcaagcctgtttaataggacatatatgactaatagtacagatatggctaatagtacagaaactaacagaaccatcacaatccactgcagaataaaacagattataaacatgtggcaggaggtgggacgagcaatgtatgcccctcccattgcaggaaacataacatgtatatcaaatatcacaggactactattgacaagggatggaggaaacagcagtacggggacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgttgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcctctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattagataccctagcaatagcagtaggtgaaggaacagataggattctagaatttgtattaggaatttgtagagctatccgcaacatacctacaagaataagacagggctttgaaacagctttgctataa

SEQ ID NO: 826 - DNA, 2568 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacggagacatccgagacagtctccgagatattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaccagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 827 - DNA, 2547 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatttggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtgaagagagaaaaaagagcagtgggaatgggagctatgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 828 - DNA, 2592 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaaggatatgagaaggaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgtcagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataggaataggaccaggacaagcattttatgcaacaggacaagtaataggagacataagaaaagcacattgtaacattagtgaaagtaaatggaatgaaactttacaaagggtaagtaaaaaattaaaagaatacttccctggtaagaatataacatttcaaccatcctcaggaggggacccagaagttacaacacatagctttaattgtggaggagaatttttctattgcaatacatcaagcctgtttaatagaacatatatgactaatagtacagatatggctaatagtacagaaactaacagaaccatcacaatccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaagcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagggagaaattagcaattatacaaacataatatatgacttgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacgaagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 829 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgttagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 830 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaaaataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcaatgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 831 - DNA, 2589 bp, Human immunodeficiency virus
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaaggatatgagaaggaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgtcagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcaccacagtacaatgtacacatggaattaagccagtggtttcaactcaactattgttaaatggtagcctagcagaaggagagataataattagatctaaaaatataacagacaatggcaacacaataatagtacatctcaatgaatctgtaaagattgagtgtacgagacccggtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaagttacaacacatagctttaattgtggaggagaatttttctattgcaatacatcaagcctgtttaataggacatatatgactaatagtacagatatggctaatagtacagaaactaacagaaccatcacaatccactgcagaataaaacaaattataaacatgtggcaggaggtgggacgagcaatgtatgctcctcccattgcaggaaacataacatgtatatcaaatatcacaggactactattgacaagggatggaggaaacaatacggatccggagatattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagtgaaattagcaattatacaaacataatatatgatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcacattaattgcagcgagagcgggggaacttctgggacgcagcagtctcaagggactacgaagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 832 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 833 - DNA, 2547 bp, Human immunodeficiency virus
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttacgaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaagagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 834 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagcaataacacaagaacaagtataagaataggaccaggacaagcattttatgcaacaggacaagtaataggaaatataagagaagcacattgtaacattagtgaaagtaaatggaatgagactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagagggtacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 835 - DNA, 2555 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtagtaggaaatataagagaagcacattgtaacattagtgaaagtaaatggaatgagactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgagggaacagataggattctagaatttgtattaggaatttgtagagctatccgcaacatacctacaaggataagacagggctttgaaacagctttgctataa

SEQ ID NO: 836 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcaatgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 837 - DNA, 2547 bp, Human immunodeficiency virus
atgagagtgagggggatacagaggagttatccacaatggtggatatggagcatgttaggcctttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggtttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 838 - DNA, 2547 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacagaaataatatatgacttgcttgaagaatcacaaaaccagcaggaaaagaatgaacaagatttactagcattggacagatggaatagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 839 - DNA, 2556 bp, Human immunodeficiency virus; identical to SEQ ID NO: 836

SEQ ID NO: 840 - DNA, 2558 bp, Human immunodeficiency virus
atgagagtgaaggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatactactgacagcaatagcaatatattagagggaatgaaaaattgctctttcaatataaccacagaattaagagataagagagagaaaaagaatgcacttttttataaacttgatatagtacaactaggtggcaactctagtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggaaagataataattaggtctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaattgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtaagggaacagataggattctagaatttgtattaggaatttgtagagctatccgcaacatacctacaagaataagacagggctttgaaacagctttgctataa

SEQ ID NO: 841 - DNA, 2556 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacggaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaactgcttgaagaatcacaaaaccagcaggaaaagaatgaacaagatttactagcattggacagatggaacagtctatggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 842 - DNA, 2547 bp, Human immunodeficiency virus
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgactccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 843 - DNA, 2589 bp, Human immunodeficiency virus
atgagagtgatggggagacagaggaattatccacaatggtggatatggagcacgttaggcttgcggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgtcagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataggaataggaccaggacaagcattttatgcaacaggacaagtaataggagacataagaaaagcacattgtaacattagtgaaagtaaatggaatgaaactttacaaagggtaagtaaaaaattaaaagaatacttccctggtaagaatataacatttcaaccatcctcaggaggggacccagaagttacaacacatagctttaattgtggaggagaatttttctattgcaatacatcaagcctgtttaataggacatatatgactaatagtacagatatggctaatagtacagaaactaacagaaccatcacaatccactgcagaataaaacaaattataaacatgtggcaagaggtgggacgagcaatgtatgcccctcccattgcaggaaacataacatgtatatcaaatatcacaggactactattgacaagggatggaggaaacaatacggatccggagatattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcgtcaataacgctgacggtacaggccagacaactattgtctggtatagtgcaacagcaaagcaatttgctgaaggctatagaggctcaacagcacatgttgagactcacggtctggggcattaaacagctccaggcaagagtcctggccttggaaagatacctaaaggatcaacagctcctagggatgtggggctgctctggaaaactcatttgcaccactaatgtatattggaactctagttggagtaataaaacttatggtgatatttgggataacatgacctggatgcagtgggagagcgaaattagcaattatacaaacataatatatgatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 844 - protein, 846 aa, Human immunodeficiency virus; identical to SEQ ID NO: 15

SEQ ID NO: 845 - protein, 846 aa, Human immunodeficiency virus; identical to SEQ ID NO: 51

SEQ ID NO: 846 - protein, 846 aa, Human immunodeficiency virus; identical to SEQ ID NO: 90

SEQ ID NO: 847 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 848 - protein, 846 aa, Human immunodeficiency virus; identical to SEQ ID NO: 157

SEQ ID NO: 849 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 850 - protein, 846 aa, Human immunodeficiency virus; identical to SEQ ID NO: 239

SEQ ID NO: 851 - protein, 846 aa, Human immunodeficiency virus; identical to SEQ ID NO: 298

SEQ ID NO: 852 - protein, 859 aa, Human immunodeficiency virus; identical to SEQ ID NO: 315

SEQ ID NO: 853 - protein, 850 aa, Human immunodeficiency virus; identical to SEQ ID NO: 318

SEQ ID NO: 854 - protein, 859 aa, Human immunodeficiency virus; identical to SEQ ID NO: 358

SEQ ID NO: 855 - protein, 849 aa, Human immunodeficiency virus; identical to SEQ ID NO: 351

SEQ ID NO: 856 - protein, 865 aa, Human immunodeficiency virus; identical to SEQ ID NO: 336

SEQ ID NO: 857 - protein, 848 aa, Human immunodeficiency virus; identical to SEQ ID NO: 342

SEQ ID NO: 858 - protein, 851 aa, Human immunodeficiency virus; identical to SEQ ID NO: 369

SEQ ID NO: 859 - protein, 862 aa, Human immunodeficiency virus; identical to SEQ ID NO: 375

SEQ ID NO: 860 - protein, 863 aa, Human immunodeficiency virus; identical to SEQ ID NO: 386

SEQ ID NO: 861 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 862 - protein, 486 aa, Artificial Sequence; identical to SEQ ID NO: 861
  Description of Artificial Sequence: Synthetic polypeptide

SEQ ID NO: 863 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRERVVEREKE

SEQ ID NO: 864 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 865 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 866 - protein, 499 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 867 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 868 - protein, 499 aa, Artificial Sequence
  Description of Artificial Sequence: Synthetic polypeptide
MRVMGIQRNYTQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARERVVEREKE

SEQ ID NO: 869 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARERVVEREKE

SEQ ID NO: 870 - protein, 505 aa, Artificial Sequence
  Description of Artificial Sequence: Synthetic polypeptide
MRVMGRQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 871 - protein, 488 aa, Artificial Sequence
  Description of Artificial Sequence: Synthetic polypeptide
MRVTGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARERVVEREKE

SEQ ID NO: 872 - protein, 491 aa, Artificial Sequence
  Description of Artificial Sequence: Synthetic polypeptide
MRVMGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 873 - protein, 502 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARERVVEREKE

SEQ ID NO: 874 - protein, 507 aa, Artificial Sequence
  Description of Artificial Sequence: Synthetic polypeptide
MRVMGIQRNYPQWWIWSMLGLWMLMTCNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARERVVEREKE

SEQ ID NO: 875 - protein, 511 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 876 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 877 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 878 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNSKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 879 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQTFYATGDVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 880 - protein, 486 aa, Artificial Sequence; identical to SEQ ID NO: 879
  Description of Artificial Sequence: Synthetic polypeptide

SEQ ID NO: 881 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQTFYATGDVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRERVVEREKE

SEQ ID NO: 882 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQTFYATGDVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 883 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQTFYATGDVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 884 - protein, 499 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQTFYATGDVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 885 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQTFYATGDVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 886 - protein, 499 aa, Artificial Sequence
  Description of Artificial Sequence: Synthetic polypeptide
MRVMGIQRNYTQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARERVVEREKE

SEQ ID NO: 887 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARERVVEREKE

SEQ ID NO: 888 - protein, 505 aa, Artificial Sequence
  Description of Artificial Sequence: Synthetic polypeptide
MRVMGRQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 889 - protein, 488 aa, Artificial Sequence
  Description of Artificial Sequence: Synthetic polypeptide
MRVTGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQTFYATGDVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARERVVEREKE

SEQ ID NO: 890 - protein, 491 aa, Artificial Sequence
  Description of Artificial Sequence: Synthetic polypeptide
MRVMGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 891 - protein, 502 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARERVVEREKE

SEQ ID NO: 892 - protein, 507 aa, Artificial Sequence
  Description of Artificial Sequence: Synthetic polypeptide
MRVMGIQRNYPQWWIWSMLGLWMLMTCNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQTFYATGDVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARERVVEREKE

SEQ ID NO: 893 - protein, 511 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQTFYATGDVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 894 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQTFYATGDVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 895 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQTFYATGDVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 896 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQTFYATGDVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 897 - protein, 494 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 898 - protein, 392 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKCPKVSFDPIPIHYCAPAGYAILKCNNKTFTGTGPCNNVSTVQCTHGIKPVVSTQLLLNGSLAEGEIIIRSENITNNVKTIIVHLNESVKIECTREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 899 - protein, 494 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKR

SEQ ID NO: 900 - protein, 494 aa, Human immunodeficiency virus; identical to SEQ ID NO: 899

SEQ ID NO: 901 - protein, 494 aa, Human immunodeficiency virus
  UNSURE (268)..(268): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNXKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKR

SEQ ID NO: 902 - protein, 497 aa, Human immunodeficiency virus
  UNSURE (132)..(135): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATXXXXSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKR

SEQ ID NO: 903 - protein, 500 aa, Human immunodeficiency virus
  UNSURE (133)..(136): Undefined mutation from wild-type sequence
  UNSURE (272)..(272): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATAXXXXSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNXKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKR

SEQ ID NO: 904 - protein, 507 aa, Human immunodeficiency virus
  UNSURE (129)..(129): Undefined mutation from wild-type sequence
  UNSURE (133)..(134): Undefined mutation from wild-type sequence
  UNSURE (136)..(137): Undefined mutation from wild-type sequence
  UNSURE (139)..(143): Undefined mutation from wild-type sequence
  UNSURE (393)..(393): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTXATAXXAXXSXXXXXNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMAXSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKR

SEQ ID NO: 905 - protein, 507 aa, Human immunodeficiency virus
  UNSURE (133)..(134): Undefined mutation from wild-type sequence
  UNSURE (136)..(137): Undefined mutation from wild-type sequence
  UNSURE (139)..(142): Undefined mutation from wild-type sequence
  UNSURE (351)..(351): Undefined mutation from wild-type sequence
  UNSURE (455)..(455): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATAXXAXXSXXXXSNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPXKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGXNNTETFETFRPGGGNMKDNWRSELYKYKVVEVKPLGVAPTNARRRVVEREKR

SEQ ID NO: 906 - protein, 504 aa, Human immunodeficiency virus
  UNSURE (137)..(139): Undefined mutation from wild-type sequence
  UNSURE (142)..(142): Undefined mutation from wild-type sequence
  UNSURE (455)..(455): Undefined mutation from wild-type sequence
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNXXXATXSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTDMANSTETNSTRTITLHCRIKQIINMWQEVGRAMYAPPIAGNITCISNITGLLLTRDGGXNNTETFRPEGGNMKDNWRSELYKYKVVEVKPLGVAPTNARRRVVEREKR

SEQ ID NO: 907 - protein, 499 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKR

SEQ ID NO: 908 - protein, 499 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKR

SEQ ID NO: 909 - protein, 283 aa, Human immunodeficiency virus
CPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEV

SEQ ID NO: 910 - protein, 258 aa, Human immunodeficiency virus
CPTVRFKPVPIRYCAPPGYAILKCNNRDFNGTGPCTNVSVVTCTDGIHPVVSSQLLLNGTLADEKVVIRSCNFSDNAKTIIVQLNTSVEINCTGQGHCNITRAKWNQTLKQIAEKLREQFGNNKTIIFRPSSGGDPEIVTHWFNCGGKFFYCNSTQLFNSTWFNSTWSTKGSNNTEGSDTITLPCRIRSITGMVCTVGKMIYAPPVEGVITCSSNITGLLLTRDGGNDNNESEIFRPGGGDMRDNWRSELYKYRVVRL

SEQ ID NO: 911 - protein, 259 aa, Artificial Sequence
  Description of Artificial Sequence: Synthetic polypeptide
MRVMGIQRNYPQWWIWSMLGFWMLMICNGSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVV

SEQ ID NO: 912 - protein, 260 aa, Artificial Sequence
  Description of Artificial Sequence: Synthetic polypeptide
MRVMGIQRNYPQWWIWSMLGFWMLMICNGQSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVV

SEQ ID NO: 913 - protein, 232 aa, Artificial Sequence
  Description of Artificial Sequence: Synthetic polypeptide
MRVMGIQRNYPQWWIWSMLGFWMLMICNGQSTQLLLNGSLAEGEIIIRSENITNNVKTIIVHLNESVKIECTREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVV

SEQ ID NO: 914 - protein, 6 aa, Human immunodeficiency virus
LTPLCV

SEQ ID NO: 915 - protein, 6 aa, Human immunodeficiency virus
TDNAKT

SEQ ID NO: 916 - protein, 10 aa, Human immunodeficiency virus
SSGGDPEIVT

SEQ ID NO: 917 - protein, 9 aa, Human immunodeficiency virus
INMWQKVGK

SEQ ID NO: 918 - protein, 6 aa, Human immunodeficiency virus
GGNSNN

SEQ ID NO: 919 - protein, 5 aa, Human immunodeficiency virus
GGGDM

SEQ ID NO: 920 - protein, 8 aa, Human immunodeficiency virus
HSGGDLEI

SEQ ID NO: 921 - protein, 7 aa, Human immunodeficiency virus
DGGNDDN

SEQ ID NO: 922 - protein, 6 aa, Human immunodeficiency virus
RGQLVN

SEQ ID NO: 923 - protein, 4 aa, Human immunodeficiency virus
ENYK

SEQ ID NO: 924 - protein, 4 aa, Human immunodeficiency virus
SKSG

SEQ ID NO: 925 - protein, 5 aa, Human immunodeficiency virus
DKLGD

SEQ ID NO: 926 - protein, 6 aa, Human immunodeficiency virus
RGQLVN
